United States Patent 12,247,232 (METHODS AND COMPOSITIONS FOR INHIBITING ADAM 9 BIOLOGICAL ACTIVITIES) - sequence listing, part 4

SEQ ID NO: 26342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 26343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 26344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 26345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 26346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 26347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 26348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 26349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 26350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 26351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 26352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 26353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 26354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 26355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 26356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 26357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 26358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 26359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 26360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 26361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 26362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 26363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 26364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 26365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 26366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 26367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 26368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 26369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 26370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 26371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 26372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 26373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 26374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 26375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 26376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 26377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 26378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 26379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 26380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 26381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 26382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 26383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 26384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 26385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 26386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 26387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 26388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 26389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 26390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 26391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 26392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 26393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 26394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 26395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 26396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 26397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 26398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 26399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 26400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 26401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 26402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 26403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 26404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 26405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 26406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 26407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 26408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 26409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 26410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 26411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 26412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 26413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 26414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 26415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 26416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 26417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 26418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 26419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 26420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 26421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 26422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 26423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 26424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 26425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 26426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 26427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 26428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 26429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 26430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 26431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 26432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 26433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 26434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 26435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 26436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 26437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 26438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 26439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 26440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 26441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 26442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 26443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 26444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 26445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 26446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 26447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 26448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 26449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 26450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 26451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 26452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 26453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 26454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 26455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 26456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 26457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 26458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 26459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 26460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 26461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 26462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 26463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 26464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 26465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 26466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 26467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 26468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 26469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 26470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 26471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 26472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 26473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 26474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 26475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 26476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 26477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 26478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 26479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 26480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 26481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 26482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 26483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 26484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 26485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 26486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 26487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 26488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 26489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 26490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 26491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 26492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 26493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 26494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 26495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 26496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 26497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 26498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 26499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 26500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 26501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 26502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 26503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 26504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 26505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 26506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 26507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 26508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 26509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 26510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 26511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 26512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 26513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 26514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 26515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 26516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 26517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 26518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 26519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 26520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 26521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 26522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 26523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 26524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 26525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 26526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 26527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 26528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 26529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 26530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 26531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 26532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 26533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 26534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 26535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 26536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 26537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 26538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 26539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 26540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 26541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 26542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 26543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 26544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 26545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 26546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 26547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 26548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 26549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 26550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 26551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 26552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 26553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 26554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 26555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 26556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 26557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 26558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 26559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 26560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 26561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 26562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 26563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 26564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 26565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 26566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 26567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 26568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 26569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 26570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 26571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 26572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 26573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 26574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 26575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 26576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 26577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 26578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 26579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 26580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 26581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 26582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 26583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 26584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 26585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 26586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 26587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 26588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 26589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 26590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 26591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 26592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 26593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 26594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 26595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 26596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 26597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 26598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 26599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 26600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 26601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 26602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 26603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 26604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 26605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 26606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 26607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 26608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 26609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 26610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 26611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 26612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 26613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 26614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 26615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 26616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 26617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 26618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 26619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 26620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 26621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 26622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 26623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 26624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 26625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 26626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 26627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 26628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 26629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 26630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 26631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 26632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 26633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 26634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 26635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 26636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 26637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 26638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 26639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 26640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 26641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 26642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 26643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 26644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 26645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 26646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 26647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 26648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 26649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 26650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 26651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 26652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 26653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 26654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 26655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 26656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 26657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 26658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 26659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 26660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 26661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 26662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 26663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 26664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 26665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 26666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 26667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 26668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 26669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 26670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 26671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 26672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 26673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 26674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 26675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 26676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 26677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 26678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 26679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 26680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 26681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 26682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 26683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 26684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 26685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 26686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 26687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 26688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 26689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 26690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 26691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 26692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 26693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 26694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 26695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 26696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 26697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 26698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 26699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 26700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 26701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 26702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 26703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 26704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 26705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 26706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 26707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 26708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 26709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 26710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 26711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 26712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 26713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 26714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 26715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 26716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 26717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 26718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 26719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 26720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 26721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 26722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 26723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 26724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 26725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 26726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 26727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 26728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 26729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 26730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 26731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 26732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 26733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 26734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 26735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 26736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 26737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 26738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 26739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 26740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 26741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 26742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 26743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 26744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 26745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 26746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 26747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 26748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 26749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 26750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 26751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 26752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 26753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 26754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 26755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 26756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 26757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 26758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 26759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 26760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 26761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 26762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 26763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 26764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 26765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 26766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 26767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 26768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 26769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 26770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 26771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 26772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 26773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 26774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 26775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 26776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 26777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 26778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 26779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 26780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 26781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 26782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 26783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 26784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 26785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 26786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 26787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 26788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 26789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 26790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 26791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 26792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 26793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 26794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 26795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 26796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 26797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 26798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 26799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 26800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 26801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 26802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 26803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 26804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 26805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 26806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 26807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 26808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 26809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 26810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 26811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 26812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 26813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 26814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 26815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 26816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 26817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 26818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 26819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 26820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 26821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 26822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 26823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 26824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 26825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 26826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 26827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 26828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 26829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 26830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 26831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 26832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 26833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 26834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 26835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 26836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 26837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 26838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 26839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 26840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 26841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 26842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 26843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 26844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 26845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 26846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 26847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 26848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 26849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 26850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 26851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 26852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 26853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 26854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 26855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 26856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 26857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 26858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 26859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 26860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 26861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 26862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 26863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 26864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 26865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 26866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 26867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 26868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 26869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 26870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 26871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 26872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 26873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 26874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 26875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 26876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 26877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 26878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 26879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 26880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 26881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 26882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 26883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 26884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 26885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 26886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 26887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 26888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 26889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 26890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 26891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 26892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 26893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 26894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 26895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 26896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 26897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 26898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 26899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 26900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 26901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 26902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 26903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 26904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 26905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 26906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 26907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 26908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 26909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 26910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 26911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 26912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 26913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 26914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 26915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 26916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 26917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 26918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 26919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 26920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 26921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 26922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 26923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 26924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 26925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 26926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 26927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 26928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 26929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 26930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 26931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 26932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 26933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 26934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 26935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 26936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 26937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 26938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 26939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 26940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 26941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 26942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 26943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 26944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 26945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 26946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 26947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 26948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 26949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 26950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 26951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 26952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 26953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 26954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 26955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 26956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 26957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 26958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 26959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 26960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 26961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 26962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 26963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 26964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 26965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 26966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 26967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 26968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 26969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 26970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 26971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 26972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 26973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 26974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 26975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 26976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 26977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 26978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 26979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 26980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 26981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 26982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 26983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 26984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 26985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 26986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 26987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 26988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 26989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 26990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 26991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 26992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 26993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 26994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 26995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 26996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 26997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 26998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 26999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 27000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 27001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 27002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 27003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 27004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 27005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 27006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 27007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 27008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 27009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 27010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 27011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 27012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 27013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 27014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 27015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 27016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 27017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 27018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 27019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 27020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 27021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 27022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 27023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 27024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 27025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 27026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 27027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHMHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 27028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 27029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 27030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 27031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 27032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 27033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 27034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 27035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 27036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 27037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 27038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 27039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 27040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 27041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 27042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 27043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 27044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 27045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 27046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 27047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 27048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 27049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 27050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 27051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 27052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 27053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 27054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 27055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 27056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 27057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 27058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 27059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 27060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 27061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 27062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 27063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 27064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 27065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 27066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 27067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 27068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 27069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 27070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 27071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 27072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 27073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 27074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 27075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 27076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 27077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 27078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 27079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 27080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 27081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 27082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 27083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 27084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 27085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 27086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 27087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 27088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 27089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 27090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 27091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 27092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 27093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 27094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 27095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 27096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 27097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 27098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 27099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 27100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 27101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 27102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 27103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 27104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 27105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 27106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 27107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 27108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 27109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 27110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 27111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 27112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 27113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 27114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 27115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 27116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 27117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 27118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 27119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 27120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 27121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 27122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 27123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 27124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 27125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 27126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 27127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 27128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 27129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 27130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 27131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 27132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 27133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 27134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 27135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 27136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 27137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 27138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 27139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 27140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 27141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 27142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 27143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 27144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 27145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 27146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 27147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 27148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 27149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 27150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 27151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 27152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 27153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 27154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 27155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 27156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 27157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 27158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 27159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 27160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 27161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 27162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 27163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 27164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 27165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 27166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 27167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 27168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 27169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 27170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 27171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 27172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 27173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 27174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 27175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 27176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 27177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 27178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 27179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 27180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 27181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 27182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 27183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 27184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 27185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 27186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 27187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 27188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 27189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 27190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 27191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 27192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 27193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 27194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 27195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 27196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 27197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 27198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 27199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 27200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 27201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 27202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 27203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 27204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 27205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 27206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 27207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 27208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 27209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 27210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 27211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 27212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 27213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 27214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 27215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 27216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 27217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 27218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 27219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 27220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 27221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 27222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 27223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 27224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 27225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 27226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 27227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 27228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 27229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 27230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 27231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 27232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 27233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 27234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 27235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 27236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 27237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 27238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 27239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 27240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 27241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 27242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 27243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 27244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 27245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 27246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 27247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 27248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 27249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 27250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 27251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 27252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 27253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 27254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 27255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 27256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 27257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 27258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 27259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 27260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 27261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 27262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 27263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 27264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 27265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 27266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 27267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 27268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 27269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 27270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 27271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 27272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 27273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 27274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 27275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 27276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 27277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 27278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 27279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 27280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 27281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 27282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 27283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 27284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 27285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 27286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 27287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 27288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 27289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 27290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 27291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 27292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 27293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 27294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 27295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 27296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 27297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 27298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 27299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 27300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 27301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 27302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 27303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 27304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 27305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 27306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 27307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 27308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 27309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 27310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 27311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 27312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 27313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 27314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 27315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 27316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 27317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 27318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 27319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 27320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 27321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 27322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 27323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 27324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 27325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 27326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 27327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 27328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 27329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 27330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 27331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 27332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 27333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 27334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 27335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 27336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 27337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 27338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 27339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 27340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 27341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 27342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 27343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 27344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 27345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 27346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 27347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 27348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 27349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 27350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 27351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 27352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 27353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 27354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 27355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 27356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 27357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 27358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 27359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 27360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 27361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 27362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 27363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 27364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 27365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 27366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 27367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 27368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 27369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 27370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 27371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 27372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 27373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 27374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 27375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 27376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 27377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 27378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 27379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 27380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 27381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 27382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 27383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 27384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 27385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 27386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 27387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 27388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 27389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 27390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 27391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 27392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 27393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 27394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 27395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 27396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 27397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 27398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 27399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 27400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 27401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 27402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 27403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 27404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 27405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 27406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 27407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 27408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 27409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 27410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 27411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 27412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 27413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 27414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 27415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 27416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 27417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 27418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 27419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 27420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 27421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 27422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 27423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 27424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 27425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 27426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 27427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 27428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 27429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 27430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 27431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 27432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 27433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 27434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 27435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 27436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 27437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 27438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 27439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 27440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 27441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 27442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 27443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 27444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 27445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 27446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 27447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 27448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 27449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 27450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 27451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 27452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 27453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 27454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 27455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 27456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 27457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 27458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 27459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 27460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 27461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 27462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 27463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 27464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 27465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 27466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 27467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 27468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 27469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 27470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 27471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 27472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 27473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 27474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 27475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 27476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 27477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 27478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 27479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 27480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 27481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 27482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 27483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 27484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 27485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 27486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 27487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 27488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 27489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 27490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 27491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 27492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 27493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 27494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 27495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 27496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 27497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 27498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 27499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 27500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 27501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 27502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 27503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 27504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 27505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 27506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 27507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 27508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 27509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 27510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 27511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 27512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 27513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 27514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 27515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 27516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 27517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 27518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 27519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 27520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 27521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 27522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 27523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 27524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 27525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 27526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 27527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 27528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 27529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 27530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 27531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 27532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 27533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 27534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 27535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 27536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 27537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 27538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 27539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 27540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 27541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 27542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 27543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 27544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 27545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 27546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 27547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 27548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 27549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 27550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 27551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 27552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 27553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 27554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 27555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 27556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 27557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 27558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 27559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 27560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 27561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 27562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 27563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 27564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 27565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 27566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 27567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 27568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 27569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 27570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 27571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 27572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 27573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 27574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 27575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 27576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 27577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 27578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 27579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 27580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 27581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 27582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 27583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 27584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 27585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 27586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 27587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 27588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 27589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 27590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 27591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 27592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 27593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 27594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 27595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 27596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 27597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 27598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 27599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 27600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 27601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 27602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 27603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 27604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 27605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 27606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 27607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 27608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 27609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 27610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 27611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 27612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 27613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 27614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 27615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 27616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 27617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 27618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 27619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 27620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 27621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 27622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 27623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 27624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 27625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 27626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 27627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 27628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 27629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 27630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 27631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 27632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 27633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 27634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 27635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 27636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 27637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 27638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 27639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 27640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 27641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 27642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 27643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 27644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 27645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 27646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 27647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 27648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 27649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 27650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 27651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 27652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 27653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 27654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 27655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 27656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 27657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 27658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 27659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 27660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 27661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 27662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 27663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 27664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 27665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 27666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 27667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 27668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 27669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 27670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 27671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 27672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 27673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 27674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 27675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 27676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 27677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 27678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 27679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 27680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 27681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 27682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 27683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 27684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 27685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 27686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 27687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 27688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 27689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 27690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 27691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 27692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 27693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 27694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 27695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 27696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 27697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 27698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 27699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 27700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 27701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 27702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 27703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 27704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 27705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 27706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 27707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 27708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 27709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 27710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 27711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 27712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 27713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 27714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 27715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 27716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 27717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 27718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 27719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 27720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 27721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 27722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 27723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 27724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 27725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 27726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 27727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 27728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 27729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 27730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 27731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 27732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 27733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 27734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 27735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 27736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 27737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 27738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 27739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 27740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 27741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 27742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 27743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 27744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 27745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 27746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 27747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 27748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 27749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 27750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 27751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 27752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 27753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 27754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 27755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 27756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 27757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 27758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 27759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 27760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 27761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 27762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 27763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 27764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 27765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 27766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 27767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 27768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 27769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 27770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 27771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 27772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 27773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 27774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 27775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 27776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 27777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 27778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 27779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 27780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 27781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 27782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 27783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 27784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 27785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 27786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 27787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 27788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 27789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 27790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 27791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 27792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 27793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 27794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 27795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 27796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 27797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 27798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 27799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 27800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 27801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 27802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 27803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 27804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 27805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 27806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 27807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 27808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 27809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 27810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 27811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 27812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 27813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 27814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 27815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 27816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 27817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 27818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 27819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 27820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 27821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 27822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 27823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 27824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 27825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 27826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 27827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 27828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 27829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 27830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 27831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 27832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 27833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 27834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 27835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 27836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 27837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 27838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 27839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 27840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 27841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 27842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 27843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 27844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 27845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 27846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 27847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 27848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 27849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 27850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 27851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 27852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 27853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 27854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 27855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 27856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 27857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 27858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 27859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 27860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 27861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 27862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 27863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 27864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 27865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 27866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 27867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 27868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 27869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 27870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 27871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 27872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 27873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 27874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 27875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 27876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 27877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 27878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 27879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 27880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 27881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 27882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 27883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 27884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 27885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 27886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 27887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 27888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 27889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 27890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 27891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 27892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 27893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 27894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 27895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 27896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 27897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 27898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 27899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 27900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 27901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 27902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 27903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 27904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 27905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 27906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 27907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 27908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 27909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 27910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 27911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 27912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 27913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 27914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 27915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 27916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 27917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 27918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 27919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 27920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 27921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 27922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 27923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 27924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 27925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 27926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 27927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 27928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 27929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 27930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 27931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 27932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 27933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 27934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 27935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 27936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 27937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 27938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 27939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 27940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 27941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 27942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 27943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 27944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 27945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 27946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 27947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 27948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 27949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 27950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 27951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 27952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 27953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 27954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 27955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 27956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 27957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 27958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 27959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 27960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 27961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 27962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 27963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 27964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 27965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 27966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 27967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 27968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 27969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 27970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 27971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 27972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 27973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 27974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 27975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 27976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 27977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 27978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 27979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 27980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 27981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 27982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 27983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 27984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 27985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 27986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 27987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 27988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 27989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 27990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 27991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 27992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 27993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 27994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 27995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 27996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 27997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 27998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 27999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 28000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 28001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 28002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 28003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 28004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 28005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 28006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 28007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 28008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 28009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 28010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 28011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 28012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 28013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 28014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 28015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 28016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 28017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 28018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 28019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 28020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 28021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 28022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 28023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 28024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 28025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 28026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 28027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 28028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 28029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 28030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 28031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 28032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 28033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 28034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 28035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 28036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 28037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 28038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 28039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 28040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 28041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 28042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 28043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 28044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 28045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 28046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 28047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 28048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 28049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 28050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 28051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 28052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 28053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 28054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 28055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 28056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 28057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 28058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 28059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 28060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 28061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 28062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 28063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 28064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 28065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 28066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 28067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 28068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 28069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 28070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 28071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 28072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 28073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 28074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 28075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 28076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 28077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 28078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 28079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 28080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 28081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 28082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 28083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 28084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 28085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 28086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 28087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 28088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 28089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 28090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 28091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 28092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 28093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 28094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 28095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 28096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 28097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 28098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 28099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 28100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 28101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 28102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 28103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 28104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 28105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 28106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 28107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 28108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 28109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 28110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 28111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 28112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 28113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 28114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 28115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 28116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 28117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 28118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 28119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 28120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 28121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 28122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 28123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 28124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 28125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 28126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 28127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 28128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 28129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 28130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 28131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 28132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 28133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 28134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 28135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 28136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 28137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 28138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 28139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 28140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 28141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 28142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 28143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 28144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 28145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 28146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 28147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 28148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 28149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 28150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 28151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 28152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 28153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 28154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 28155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 28156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 28157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 28158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 28159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 28160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 28161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 28162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 28163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 28164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 28165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 28166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 28167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 28168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 28169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 28170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 28171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 28172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 28173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 28174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 28175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 28176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 28177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 28178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 28179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 28180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 28181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 28182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 28183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 28184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 28185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 28186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 28187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 28188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 28189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 28190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 28191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 28192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 28193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 28194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 28195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 28196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 28197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 28198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 28199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 28200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 28201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 28202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 28203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 28204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 28205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 28206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 28207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 28208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 28209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 28210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 28211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 28212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 28213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 28214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 28215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 28216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 28217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 28218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 28219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 28220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 28221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 28222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 28223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 28224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 28225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 28226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 28227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 28228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 28229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 28230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 28231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 28232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 28233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 28234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 28235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 28236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 28237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 28238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 28239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 28240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 28241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 28242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 28243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 28244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 28245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 28246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 28247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 28248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 28249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 28250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 28251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 28252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 28253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 28254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 28255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 28256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 28257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 28258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 28259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 28260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 28261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 28262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 28263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 28264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 28265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 28266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 28267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 28268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 28269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 28270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 28271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 28272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 28273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 28274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 28275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 28276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 28277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 28278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 28279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 28280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 28281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 28282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 28283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 28284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 28285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 28286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 28287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 28288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 28289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 28290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 28291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 28292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 28293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 28294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 28295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 28296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 28297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 28298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 28299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 28300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 28301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 28302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 28303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 28304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 28305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 28306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 28307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 28308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 28309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 28310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 28311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 28312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 28313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 28314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 28315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 28316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 28317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 28318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 28319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 28320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 28321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 28322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 28323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 28324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 28325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 28326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 28327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 28328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 28329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 28330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 28331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 28332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 28333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 28334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 28335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 28336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 28337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 28338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 28339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 28340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 28341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 28342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 28343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 28344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 28345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 28346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 28347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 28348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 28349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 28350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 28351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 28352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 28353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 28354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 28355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 28356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 28357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 28358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 28359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 28360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 28361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 28362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 28363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 28364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 28365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 28366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 28367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 28368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 28369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 28370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 28371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 28372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 28373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 28374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 28375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 28376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 28377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 28378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 28379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 28380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 28381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 28382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 28383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 28384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 28385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 28386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 28387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 28388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 28389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 28390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 28391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 28392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 28393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 28394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 28395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 28396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 28397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 28398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 28399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 28400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 28401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 28402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 28403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 28404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 28405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 28406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 28407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 28408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 28409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 28410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 28411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 28412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 28413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 28414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 28415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 28416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 28417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 28418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 28419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 28420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 28421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 28422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 28423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 28424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 28425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 28426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 28427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 28428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 28429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 28430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 28431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 28432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 28433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 28434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 28435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 28436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 28437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 28438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 28439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 28440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 28441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 28442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 28443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 28444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 28445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 28446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 28447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 28448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 28449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 28450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 28451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 28452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 28453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 28454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 28455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 28456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 28457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 28458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 28459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 28460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 28461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 28462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 28463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 28464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 28465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 28466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 28467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 28468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 28469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 28470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 28471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 28472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 28473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 28474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 28475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 28476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 28477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 28478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 28479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 28480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 28481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 28482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 28483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 28484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 28485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 28486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 28487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 28488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 28489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 28490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 28491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 28492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 28493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 28494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 28495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 28496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 28497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 28498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 28499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 28500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 28501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 28502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 28503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 28504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 28505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 28506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 28507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 28508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 28509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 28510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 28511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 28512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 28513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 28514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 28515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 28516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 28517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 28518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 28519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 28520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 28521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 28522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 28523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 28524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 28525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 28526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 28527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 28528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 28529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 28530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 28531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 28532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 28533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 28534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 28535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 28536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 28537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 28538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 28539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 28540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 28541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 28542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 28543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 28544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 28545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 28546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 28547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 28548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 28549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 28550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 28551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 28552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 28553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 28554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 28555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 28556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 28557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 28558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 28559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 28560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 28561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 28562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 28563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 28564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 28565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 28566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 28567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 28568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 28569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 28570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 28571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 28572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 28573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 28574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 28575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 28576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 28577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 28578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 28579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 28580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 28581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 28582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 28583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 28584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 28585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 28586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 28587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 28588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 28589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 28590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 28591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 28592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 28593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 28594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 28595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 28596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 28597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 28598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 28599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 28600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 28601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 28602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 28603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 28604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 28605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 28606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 28607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 28608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 28609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 28610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 28611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 28612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 28613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 28614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 28615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 28616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 28617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 28618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 28619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 28620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 28621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 28622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 28623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 28624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 28625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 28626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 28627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 28628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 28629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 28630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 28631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 28632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 28633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 28634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 28635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 28636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 28637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 28638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 28639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 28640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 28641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 28642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 28643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 28644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 28645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 28646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 28647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 28648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 28649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 28650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 28651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 28652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 28653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 28654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 28655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 28656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 28657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 28658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 28659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 28660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 28661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 28662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 28663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 28664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 28665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 28666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 28667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 28668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 28669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 28670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 28671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 28672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 28673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 28674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 28675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 28676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 28677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 28678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 28679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 28680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 28681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 28682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 28683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 28684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 28685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 28686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 28687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 28688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 28689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 28690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 28691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 28692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 28693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 28694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 28695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 28696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 28697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 28698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 28699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 28700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 28701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 28702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 28703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 28704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 28705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 28706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 28707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 28708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 28709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 28710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 28711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 28712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 28713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 28714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 28715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 28716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 28717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 28718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 28719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 28720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 28721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 28722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 28723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 28724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 28725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 28726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 28727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 28728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 28729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 28730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 28731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 28732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 28733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 28734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 28735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 28736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 28737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 28738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 28739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 28740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 28741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 28742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 28743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 28744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 28745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 28746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 28747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 28748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 28749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 28750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 28751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 28752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 28753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 28754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 28755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 28756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 28757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 28758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 28759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 28760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 28761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 28762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 28763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 28764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 28765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 28766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 28767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 28768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 28769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 28770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 28771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 28772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 28773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 28774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 28775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 28776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 28777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 28778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 28779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 28780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 28781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 28782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 28783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 28784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 28785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 28786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 28787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 28788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 28789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 28790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 28791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 28792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 28793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 28794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 28795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 28796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 28797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 28798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 28799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 28800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 28801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 28802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 28803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 28804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 28805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 28806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 28807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 28808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 28809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 28810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 28811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 28812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 28813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 28814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 28815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 28816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 28817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 28818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 28819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 28820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 28821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 28822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 28823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 28824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 28825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 28826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 28827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 28828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 28829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 28830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 28831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 28832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 28833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 28834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 28835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 28836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 28837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 28838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 28839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 28840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 28841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 28842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 28843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 28844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 28845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 28846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 28847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 28848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 28849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 28850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 28851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 28852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 28853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 28854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 28855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 28856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 28857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 28858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 28859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 28860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 28861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 28862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 28863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 28864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 28865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 28866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 28867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 28868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 28869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 28870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 28871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 28872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 28873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 28874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 28875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 28876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 28877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 28878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 28879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 28880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 28881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 28882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 28883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 28884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 28885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 28886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 28887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 28888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 28889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 28890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 28891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 28892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 28893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 28894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 28895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 28896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 28897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 28898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 28899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 28900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 28901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 28902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 28903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 28904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 28905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 28906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 28907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 28908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 28909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 28910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 28911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 28912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 28913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 28914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 28915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 28916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 28917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 28918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 28919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 28920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 28921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 28922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 28923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 28924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 28925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 28926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 28927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 28928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 28929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 28930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 28931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 28932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 28933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 28934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 28935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 28936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 28937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 28938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 28939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 28940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 28941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 28942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 28943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 28944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 28945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 28946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 28947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 28948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 28949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 28950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 28951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 28952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 28953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 28954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 28955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 28956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 28957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 28958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 28959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 28960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 28961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 28962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 28963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 28964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 28965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 28966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 28967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 28968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 28969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 28970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 28971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 28972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 28973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 28974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 28975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 28976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 28977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 28978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 28979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 28980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 28981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 28982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 28983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 28984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 28985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 28986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 28987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 28988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 28989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 28990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 28991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 28992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 28993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 28994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 28995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 28996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 28997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 28998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 28999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 29000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 29001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 29002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 29003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 29004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 29005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 29006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 29007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 29008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 29009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 29010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 29011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 29012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 29013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 29014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 29015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 29016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 29017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 29018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 29019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 29020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 29021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 29022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 29023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 29024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 29025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 29026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 29027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 29028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 29029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 29030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 29031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 29032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 29033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 29034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 29035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 29036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 29037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 29038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 29039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 29040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 29041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 29042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 29043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 29044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 29045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 29046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 29047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 29048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 29049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 29050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 29051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 29052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 29053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 29054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 29055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 29056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 29057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 29058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 29059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 29060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 29061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 29062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 29063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 29064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 29065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 29066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 29067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 29068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 29069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 29070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 29071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 29072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 29073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 29074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 29075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 29076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 29077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 29078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 29079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 29080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 29081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 29082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 29083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 29084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 29085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 29086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 29087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 29088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 29089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 29090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 29091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 29092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 29093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 29094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 29095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 29096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 29097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 29098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 29099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 29100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 29101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 29102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 29103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 29104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 29105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 29106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 29107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 29108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 29109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 29110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 29111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 29112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 29113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 29114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 29115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 29116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 29117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 29118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 29119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 29120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 29121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 29122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 29123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 29124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 29125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 29126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 29127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 29128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 29129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 29130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 29131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 29132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 29133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 29134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 29135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 29136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 29137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 29138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 29139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 29140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 29141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 29142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 29143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 29144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 29145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 29146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 29147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 29148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 29149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 29150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 29151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 29152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 29153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 29154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 29155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 29156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 29157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 29158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 29159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 29160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 29161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 29162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 29163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 29164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 29165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 29166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 29167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 29168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 29169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 29170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 29171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 29172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 29173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 29174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 29175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 29176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 29177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 29178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 29179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 29180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 29181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 29182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 29183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 29184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 29185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 29186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 29187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 29188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 29189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 29190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 29191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 29192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 29193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 29194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 29195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 29196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 29197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 29198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 29199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 29200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 29201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 29202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 29203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 29204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 29205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 29206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 29207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 29208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 29209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 29210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 29211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 29212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 29213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 29214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 29215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 29216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 29217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 29218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 29219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 29220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 29221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 29222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 29223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 29224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 29225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 29226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 29227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 29228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 29229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 29230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 29231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 29232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 29233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 29234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 29235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 29236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 29237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 29238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 29239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 29240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 29241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 29242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 29243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 29244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 29245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 29246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 29247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 29248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 29249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 29250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 29251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 29252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 29253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 29254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 29255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 29256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 29257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 29258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 29259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 29260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 29261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 29262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 29263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 29264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 29265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 29266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 29267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 29268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 29269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 29270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 29271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 29272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 29273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 29274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 29275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 29276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 29277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 29278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 29279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 29280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 29281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 29282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 29283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 29284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 29285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 29286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 29287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 29288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 29289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 29290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 29291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 29292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 29293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 29294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 29295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 29296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 29297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 29298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 29299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 29300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 29301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 29302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 29303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 29304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 29305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 29306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 29307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 29308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 29309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 29310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 29311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 29312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 29313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 29314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 29315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 29316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 29317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 29318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 29319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 29320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 29321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 29322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 29323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 29324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 29325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 29326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 29327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 29328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 29329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 29330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 29331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 29332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 29333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 29334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 29335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 29336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 29337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 29338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 29339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 29340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 29341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 29342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 29343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 29344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 29345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 29346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 29347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 29348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 29349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 29350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 29351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 29352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 29353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 29354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 29355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 29356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 29357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 29358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 29359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 29360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 29361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 29362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 29363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 29364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 29365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 29366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 29367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 29368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 29369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 29370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 29371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 29372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 29373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 29374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 29375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 29376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 29377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 29378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 29379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 29380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 29381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 29382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 29383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 29384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 29385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 29386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 29387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 29388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 29389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 29390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 29391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 29392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 29393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 29394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 29395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 29396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 29397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 29398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 29399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 29400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 29401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 29402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 29403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 29404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 29405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 29406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 29407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 29408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 29409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 29410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 29411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 29412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 29413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 29414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 29415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 29416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 29417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 29418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 29419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 29420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 29421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 29422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 29423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 29424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 29425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 29426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 29427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 29428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 29429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 29430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 29431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 29432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 29433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 29434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 29435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 29436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 29437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 29438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 29439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 29440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 29441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 29442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 29443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 29444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 29445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 29446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 29447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 29448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 29449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 29450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 29451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 29452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 29453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 29454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 29455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 29456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 29457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 29458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 29459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 29460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 29461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 29462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 29463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 29464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 29465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 29466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 29467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 29468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 29469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 29470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 29471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 29472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 29473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 29474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 29475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 29476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 29477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 29478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 29479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 29480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 29481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 29482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 29483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 29484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 29485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 29486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 29487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 29488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 29489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 29490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 29491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 29492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 29493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 29494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 29495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 29496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 29497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 29498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 29499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 29500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 29501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 29502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 29503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 29504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 29505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 29506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 29507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 29508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 29509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 29510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 29511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 29512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 29513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 29514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 29515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 29516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 29517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 29518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 29519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 29520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 29521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 29522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 29523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 29524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 29525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 29526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 29527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 29528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 29529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 29530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 29531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 29532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 29533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 29534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 29535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 29536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 29537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 29538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 29539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 29540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 29541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 29542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 29543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 29544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 29545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 29546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 29547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 29548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 29549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 29550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 29551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 29552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 29553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 29554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 29555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 29556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 29557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 29558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 29559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 29560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 29561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 29562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 29563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 29564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 29565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 29566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 29567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 29568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 29569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 29570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 29571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 29572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 29573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 29574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 29575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 29576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 29577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 29578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 29579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 29580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 29581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 29582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 29583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 29584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 29585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 29586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 29587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 29588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 29589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 29590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 29591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 29592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 29593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 29594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 29595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 29596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 29597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 29598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 29599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 29600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 29601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 29602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 29603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 29604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 29605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 29606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 29607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 29608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 29609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 29610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 29611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 29612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 29613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 29614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 29615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 29616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 29617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 29618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 29619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 29620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 29621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 29622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 29623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 29624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 29625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 29626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 29627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 29628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 29629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 29630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 29631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 29632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 29633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 29634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 29635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 29636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 29637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 29638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 29639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 29640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 29641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 29642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 29643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 29644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 29645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 29646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 29647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 29648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 29649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 29650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 29651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 29652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 29653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 29654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 29655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 29656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 29657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 29658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 29659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 29660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 29661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 29662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 29663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 29664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 29665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 29666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 29667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 29668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 29669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 29670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 29671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 29672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 29673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 29674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 29675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 29676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 29677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 29678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 29679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 29680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 29681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 29682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 29683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 29684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 29685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 29686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 29687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 29688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 29689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 29690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 29691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 29692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 29693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 29694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 29695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 29696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 29697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 29698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 29699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 29700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 29701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 29702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 29703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 29704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 29705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 29706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 29707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 29708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 29709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 29710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 29711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 29712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 29713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 29714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 29715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 29716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 29717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 29718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 29719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 29720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 29721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 29722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 29723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 29724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 29725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 29726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 29727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 29728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 29729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 29730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 29731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 29732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 29733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 29734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 29735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 29736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 29737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 29738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 29739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 29740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 29741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 29742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 29743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 29744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 29745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 29746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 29747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 29748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 29749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 29750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 29751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 29752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 29753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 29754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 29755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 29756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 29757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 29758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 29759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 29760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 29761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 29762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 29763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 29764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 29765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 29766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 29767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 29768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 29769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 29770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 29771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 29772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 29773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 29774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 29775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 29776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 29777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 29778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 29779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 29780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 29781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 29782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 29783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 29784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 29785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 29786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 29787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 29788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 29789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 29790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 29791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 29792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 29793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 29794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 29795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 29796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 29797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 29798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 29799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 29800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 29801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 29802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 29803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 29804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 29805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 29806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 29807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 29808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 29809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 29810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 29811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 29812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 29813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 29814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 29815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 29816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 29817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 29818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 29819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 29820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 29821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 29822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 29823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 29824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 29825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 29826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 29827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 29828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 29829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 29830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 29831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 29832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 29833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 29834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 29835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 29836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 29837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 29838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 29839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 29840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 29841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 29842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 29843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 29844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 29845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 29846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 29847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 29848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 29849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 29850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 29851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 29852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 29853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 29854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 29855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 29856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 29857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 29858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 29859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 29860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 29861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 29862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 29863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 29864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 29865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 29866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 29867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 29868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 29869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 29870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 29871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 29872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 29873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 29874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 29875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 29876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 29877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 29878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 29879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 29880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 29881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 29882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 29883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 29884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 29885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 29886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 29887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 29888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 29889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 29890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 29891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 29892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 29893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 29894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 29895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 29896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 29897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 29898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 29899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 29900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 29901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 29902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 29903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 29904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 29905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 29906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 29907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 29908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 29909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 29910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 29911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 29912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 29913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 29914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 29915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 29916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 29917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 29918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 29919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 29920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 29921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 29922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 29923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 29924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 29925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 29926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 29927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 29928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 29929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 29930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 29931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 29932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 29933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 29934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 29935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 29936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 29937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 29938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 29939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 29940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 29941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 29942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 29943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 29944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 29945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 29946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 29947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 29948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 29949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 29950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 29951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 29952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 29953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 29954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 29955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 29956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 29957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 29958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 29959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 29960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 29961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 29962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 29963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 29964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 29965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 29966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 29967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 29968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 29969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 29970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 29971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 29972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 29973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 29974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 29975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 29976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 29977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 29978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 29979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 29980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 29981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 29982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 29983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 29984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 29985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 29986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 29987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 29988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 29989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 29990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 29991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 29992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 29993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 29994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 29995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 29996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 29997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 29998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 29999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 30000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 30001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 30002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 30003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 30004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 30005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 30006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 30007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 30008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 30009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 30010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 30011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 30012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 30013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 30014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 30015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 30016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 30017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 30018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 30019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 30020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 30021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 30022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 30023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 30024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 30025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 30026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 30027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 30028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 30029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 30030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 30031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 30032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 30033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 30034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 30035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 30036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 30037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 30038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 30039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 30040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 30041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 30042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 30043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 30044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 30045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 30046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 30047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 30048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 30049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 30050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 30051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 30052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 30053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 30054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 30055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 30056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 30057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 30058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 30059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 30060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 30061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 30062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 30063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 30064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 30065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 30066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 30067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 30068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 30069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 30070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 30071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 30072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 30073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 30074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 30075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 30076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 30077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 30078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 30079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 30080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 30081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 30082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 30083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 30084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 30085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 30086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 30087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 30088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 30089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 30090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 30091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 30092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 30093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 30094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 30095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 30096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 30097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 30098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 30099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 30100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 30101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 30102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 30103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 30104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 30105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 30106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 30107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 30108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 30109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 30110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 30111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 30112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 30113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 30114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 30115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 30116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 30117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 30118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 30119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 30120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 30121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 30122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 30123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 30124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 30125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 30126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 30127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 30128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 30129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 30130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 30131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 30132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 30133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 30134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 30135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 30136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 30137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 30138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 30139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 30140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 30141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 30142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 30143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 30144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 30145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 30146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 30147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 30148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 30149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 30150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 30151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 30152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 30153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 30154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 30155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 30156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 30157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 30158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 30159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 30160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 30161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 30162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 30163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 30164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 30165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 30166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 30167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 30168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 30169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 30170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 30171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 30172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 30173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 30174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 30175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 30176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 30177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 30178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 30179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 30180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 30181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 30182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 30183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 30184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 30185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 30186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 30187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 30188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 30189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 30190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 30191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 30192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 30193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 30194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 30195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 30196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 30197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 30198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 30199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 30200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 30201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 30202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 30203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 30204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 30205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 30206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 30207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 30208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 30209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 30210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 30211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 30212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 30213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 30214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 30215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 30216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 30217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 30218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 30219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 30220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 30221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 30222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 30223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 30224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 30225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 30226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 30227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 30228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 30229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 30230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 30231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 30232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 30233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 30234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 30235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 30236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 30237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 30238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 30239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 30240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 30241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 30242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 30243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 30244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 30245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 30246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 30247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 30248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 30249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 30250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 30251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 30252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 30253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 30254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 30255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 30256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 30257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 30258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 30259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 30260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 30261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 30262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 30263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 30264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 30265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 30266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 30267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 30268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 30269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 30270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 30271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 30272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 30273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 30274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 30275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 30276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 30277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 30278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 30279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 30280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 30281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 30282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 30283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 30284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 30285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 30286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 30287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 30288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 30289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 30290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 30291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 30292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 30293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 30294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 30295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 30296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 30297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 30298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 30299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 30300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 30301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 30302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 30303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 30304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 30305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 30306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 30307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 30308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 30309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 30310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 30311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 30312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 30313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 30314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 30315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 30316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 30317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 30318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 30319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 30320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 30321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 30322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 30323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 30324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 30325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 30326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 30327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 30328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 30329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 30330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 30331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 30332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 30333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 30334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 30335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 30336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 30337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 30338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 30339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 30340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 30341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 30342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 30343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 30344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 30345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 30346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 30347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 30348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 30349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 30350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 30351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 30352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 30353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 30354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 30355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 30356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 30357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 30358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 30359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 30360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 30361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 30362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 30363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 30364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 30365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 30366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 30367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 30368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 30369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 30370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 30371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 30372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 30373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 30374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 30375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 30376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 30377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 30378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 30379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 30380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 30381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 30382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 30383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 30384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 30385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 30386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 30387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 30388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 30389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 30390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 30391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 30392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 30393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 30394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 30395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 30396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 30397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 30398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 30399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 30400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 30401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 30402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 30403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 30404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 30405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 30406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 30407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 30408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 30409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 30410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 30411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 30412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 30413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 30414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 30415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 30416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 30417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 30418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 30419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 30420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 30421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 30422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 30423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 30424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 30425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 30426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 30427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 30428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 30429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 30430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 30431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 30432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 30433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 30434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 30435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 30436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 30437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 30438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 30439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 30440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 30441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 30442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 30443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 30444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 30445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 30446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 30447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 30448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 30449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 30450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 30451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 30452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 30453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 30454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 30455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 30456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 30457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 30458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 30459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 30460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 30461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 30462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 30463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 30464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 30465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 30466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 30467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 30468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 30469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 30470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 30471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 30472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 30473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 30474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 30475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 30476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 30477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 30478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 30479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 30480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 30481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 30482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 30483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 30484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 30485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 30486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 30487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 30488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 30489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 30490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 30491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 30492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 30493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 30494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 30495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 30496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 30497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 30498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 30499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 30500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 30501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 30502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 30503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 30504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 30505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 30506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 30507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 30508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 30509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 30510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 30511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 30512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 30513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 30514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 30515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 30516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 30517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 30518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 30519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 30520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 30521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 30522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 30523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 30524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 30525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 30526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 30527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 30528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 30529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 30530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 30531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 30532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 30533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 30534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 30535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 30536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 30537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 30538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 30539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 30540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 30541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 30542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 30543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 30544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 30545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 30546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 30547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 30548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 30549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 30550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 30551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 30552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 30553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 30554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 30555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 30556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 30557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 30558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 30559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 30560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 30561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 30562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 30563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 30564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 30565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 30566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 30567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 30568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 30569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 30570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 30571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 30572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 30573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 30574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 30575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 30576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 30577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 30578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 30579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 30580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 30581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 30582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 30583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 30584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 30585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 30586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 30587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 30588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 30589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 30590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 30591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 30592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 30593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 30594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 30595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 30596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 30597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 30598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 30599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 30600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 30601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 30602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 30603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 30604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 30605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 30606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 30607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 30608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 30609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 30610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 30611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 30612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 30613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 30614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 30615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 30616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 30617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 30618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 30619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 30620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 30621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 30622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 30623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 30624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 30625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 30626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 30627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 30628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 30629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 30630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 30631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 30632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 30633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 30634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 30635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 30636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 30637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 30638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 30639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 30640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 30641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 30642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 30643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 30644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 30645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 30646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 30647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 30648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 30649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 30650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 30651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 30652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 30653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 30654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 30655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 30656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 30657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 30658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 30659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 30660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 30661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 30662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 30663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 30664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 30665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 30666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 30667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 30668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 30669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 30670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 30671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 30672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 30673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 30674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 30675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 30676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 30677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 30678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 30679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 30680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 30681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 30682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 30683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 30684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 30685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 30686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 30687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 30688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 30689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 30690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 30691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 30692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 30693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 30694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 30695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 30696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 30697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 30698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 30699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 30700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 30701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 30702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 30703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 30704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 30705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 30706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 30707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 30708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 30709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 30710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 30711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 30712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 30713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 30714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 30715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 30716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 30717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 30718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 30719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 30720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 30721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 30722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 30723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 30724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 30725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 30726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 30727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 30728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 30729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 30730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 30731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 30732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 30733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 30734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 30735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 30736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 30737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 30738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 30739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 30740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 30741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 30742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 30743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 30744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 30745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 30746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 30747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 30748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 30749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 30750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 30751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 30752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 30753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 30754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 30755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 30756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 30757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 30758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 30759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 30760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 30761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 30762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 30763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 30764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 30765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 30766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 30767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 30768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 30769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 30770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 30771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 30772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 30773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 30774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 30775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 30776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 30777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 30778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 30779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 30780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 30781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 30782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 30783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 30784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 30785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 30786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 30787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 30788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 30789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 30790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 30791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 30792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 30793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 30794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 30795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 30796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 30797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 30798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 30799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 30800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 30801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 30802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 30803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 30804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 30805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 30806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 30807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 30808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 30809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 30810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 30811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 30812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 30813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 30814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 30815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 30816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 30817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 30818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 30819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 30820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 30821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 30822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 30823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 30824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 30825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 30826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 30827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 30828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 30829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 30830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 30831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 30832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 30833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 30834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 30835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 30836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 30837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 30838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 30839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 30840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 30841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 30842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 30843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 30844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 30845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 30846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 30847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 30848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 30849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 30850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 30851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 30852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 30853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 30854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 30855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 30856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 30857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 30858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 30859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 30860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 30861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 30862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 30863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 30864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 30865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 30866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 30867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 30868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 30869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 30870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 30871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 30872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 30873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 30874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 30875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 30876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 30877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 30878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 30879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 30880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 30881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 30882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 30883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 30884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 30885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 30886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 30887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 30888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 30889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 30890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 30891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 30892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 30893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 30894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 30895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 30896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 30897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 30898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 30899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 30900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 30901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 30902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 30903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 30904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 30905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 30906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 30907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 30908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 30909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 30910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 30911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 30912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 30913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 30914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 30915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 30916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 30917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 30918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 30919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 30920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 30921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 30922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 30923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 30924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 30925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 30926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 30927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 30928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 30929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 30930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 30931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 30932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 30933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 30934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 30935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 30936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 30937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 30938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 30939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 30940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 30941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 30942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 30943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 30944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 30945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 30946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 30947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 30948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 30949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 30950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 30951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 30952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 30953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 30954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 30955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 30956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 30957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 30958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 30959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 30960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 30961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 30962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 30963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 30964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 30965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 30966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 30967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 30968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 30969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 30970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 30971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 30972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 30973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 30974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 30975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 30976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 30977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 30978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 30979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 30980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 30981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 30982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 30983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 30984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 30985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 30986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 30987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 30988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 30989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 30990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 30991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 30992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 30993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 30994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 30995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 30996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 30997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 30998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 30999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 31000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 31001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 31002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 31003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 31004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 31005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 31006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 31007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 31008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 31009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 31010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 31011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 31012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 31013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 31014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 31015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 31016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 31017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 31018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 31019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 31020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 31021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 31022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 31023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 31024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 31025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 31026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 31027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 31028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 31029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 31030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 31031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 31032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 31033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 31034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 31035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 31036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 31037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 31038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 31039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 31040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 31041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 31042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 31043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 31044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 31045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 31046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 31047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 31048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 31049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 31050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 31051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 31052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 31053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 31054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 31055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 31056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 31057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 31058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 31059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 31060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 31061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 31062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 31063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 31064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 31065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 31066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 31067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 31068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 31069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 31070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 31071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 31072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 31073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 31074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 31075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 31076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 31077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 31078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 31079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 31080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 31081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 31082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 31083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 31084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 31085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 31086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 31087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 31088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 31089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 31090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 31091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 31092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 31093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 31094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 31095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 31096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 31097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 31098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 31099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 31100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 31101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 31102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 31103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 31104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 31105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 31106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 31107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 31108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 31109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 31110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 31111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 31112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 31113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 31114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 31115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 31116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 31117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 31118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 31119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 31120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 31121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 31122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 31123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 31124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 31125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 31126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 31127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 31128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 31129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 31130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 31131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 31132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 31133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 31134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 31135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 31136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 31137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 31138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 31139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 31140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 31141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 31142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 31143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 31144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 31145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 31146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 31147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 31148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 31149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 31150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 31151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 31152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 31153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 31154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 31155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 31156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 31157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 31158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 31159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 31160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 31161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 31162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 31163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 31164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 31165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 31166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 31167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 31168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 31169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 31170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 31171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 31172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 31173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 31174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 31175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 31176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 31177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 31178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 31179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 31180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 31181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 31182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 31183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 31184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 31185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 31186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 31187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 31188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 31189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 31190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 31191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 31192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 31193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 31194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 31195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 31196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 31197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 31198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 31199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 31200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 31201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 31202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 31203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 31204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 31205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 31206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 31207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 31208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 31209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 31210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 31211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 31212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 31213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 31214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 31215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 31216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 31217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 31218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 31219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 31220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 31221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 31222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 31223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 31224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 31225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 31226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 31227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 31228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 31229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 31230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 31231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 31232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 31233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 31234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 31235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 31236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 31237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 31238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 31239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 31240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 31241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 31242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 31243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 31244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 31245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 31246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 31247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 31248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 31249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 31250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 31251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 31252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 31253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 31254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 31255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 31256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 31257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 31258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 31259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 31260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 31261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 31262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 31263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 31264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 31265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 31266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 31267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 31268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 31269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 31270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 31271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 31272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 31273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 31274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 31275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 31276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 31277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 31278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 31279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 31280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 31281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 31282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 31283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 31284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 31285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 31286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 31287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 31288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 31289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 31290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 31291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 31292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 31293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 31294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 31295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 31296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 31297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 31298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 31299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 31300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 31301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 31302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 31303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 31304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 31305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 31306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 31307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 31308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 31309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 31310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 31311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 31312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 31313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 31314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 31315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 31316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 31317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 31318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 31319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 31320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 31321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 31322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 31323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 31324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 31325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 31326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 31327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 31328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 31329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 31330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 31331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 31332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 31333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 31334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 31335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 31336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 31337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 31338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 31339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 31340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 31341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 31342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 31343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 31344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 31345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 31346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 31347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 31348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 31349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 31350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 31351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 31352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 31353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 31354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 31355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 31356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 31357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 31358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 31359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 31360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 31361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 31362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 31363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 31364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 31365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 31366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 31367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 31368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 31369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 31370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 31371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 31372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 31373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 31374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 31375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 31376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 31377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 31378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 31379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 31380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 31381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 31382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 31383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 31384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 31385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 31386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 31387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 31388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 31389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 31390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 31391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 31392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 31393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 31394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 31395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 31396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 31397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 31398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 31399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 31400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 31401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 31402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 31403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 31404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 31405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 31406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 31407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 31408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 31409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 31410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 31411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 31412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 31413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 31414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 31415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 31416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 31417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 31418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 31419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 31420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 31421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 31422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 31423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 31424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 31425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 31426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 31427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 31428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 31429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 31430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 31431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 31432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 31433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 31434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 31435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 31436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 31437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 31438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 31439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 31440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 31441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 31442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 31443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 31444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 31445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 31446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 31447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 31448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 31449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 31450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 31451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 31452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 31453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 31454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 31455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 31456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 31457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 31458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 31459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 31460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 31461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 31462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 31463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 31464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 31465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 31466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 31467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 31468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 31469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 31470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 31471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 31472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 31473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 31474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 31475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 31476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 31477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 31478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 31479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 31480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 31481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 31482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 31483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 31484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 31485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 31486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 31487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 31488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 31489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 31490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 31491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 31492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 31493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 31494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 31495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 31496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 31497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 31498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 31499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 31500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 31501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 31502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 31503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 31504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 31505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 31506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 31507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 31508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 31509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 31510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 31511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 31512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 31513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 31514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 31515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 31516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 31517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 31518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 31519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 31520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 31521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 31522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 31523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 31524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 31525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 31526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 31527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 31528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 31529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 31530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 31531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 31532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 31533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 31534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 31535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 31536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 31537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 31538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 31539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 31540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 31541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 31542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 31543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 31544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 31545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 31546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 31547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 31548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 31549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 31550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 31551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 31552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 31553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 31554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 31555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 31556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 31557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 31558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 31559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 31560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 31561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 31562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 31563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 31564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 31565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 31566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 31567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 31568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 31569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 31570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 31571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 31572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 31573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 31574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 31575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 31576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 31577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 31578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 31579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 31580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 31581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 31582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 31583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 31584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 31585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 31586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 31587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 31588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 31589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 31590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 31591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 31592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 31593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 31594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 31595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 31596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 31597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 31598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 31599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 31600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 31601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 31602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 31603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 31604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 31605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 31606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 31607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 31608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 31609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 31610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 31611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 31612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 31613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 31614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 31615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 31616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 31617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 31618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 31619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 31620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 31621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 31622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 31623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 31624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 31625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 31626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 31627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 31628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 31629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 31630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 31631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 31632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 31633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 31634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 31635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 31636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 31637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 31638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 31639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 31640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 31641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 31642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 31643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 31644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 31645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 31646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 31647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 31648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 31649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 31650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 31651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 31652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 31653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 31654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 31655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 31656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 31657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 31658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 31659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 31660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 31661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 31662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 31663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 31664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 31665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 31666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 31667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 31668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 31669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 31670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 31671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 31672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 31673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 31674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 31675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 31676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 31677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 31678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 31679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 31680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 31681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 31682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 31683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 31684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 31685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 31686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 31687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 31688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 31689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 31690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 31691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 31692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 31693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 31694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 31695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 31696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 31697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 31698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 31699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 31700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 31701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 31702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 31703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 31704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 31705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 31706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 31707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 31708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 31709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 31710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 31711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 31712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 31713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 31714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 31715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 31716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 31717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 31718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 31719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 31720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 31721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 31722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 31723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 31724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 31725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 31726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 31727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 31728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 31729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 31730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 31731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 31732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 31733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 31734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 31735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 31736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 31737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 31738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 31739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 31740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 31741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 31742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 31743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 31744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 31745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 31746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 31747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 31748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 31749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 31750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 31751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 31752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 31753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 31754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 31755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 31756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 31757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 31758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 31759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 31760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 31761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 31762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 31763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 31764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 31765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 31766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 31767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 31768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 31769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 31770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 31771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 31772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 31773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 31774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 31775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 31776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 31777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 31778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 31779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 31780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 31781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 31782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 31783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 31784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 31785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 31786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 31787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 31788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 31789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 31790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 31791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 31792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 31793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 31794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 31795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 31796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 31797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 31798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 31799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 31800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 31801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 31802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 31803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 31804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 31805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 31806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 31807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 31808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 31809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 31810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 31811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 31812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 31813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 31814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 31815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 31816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 31817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 31818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 31819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 31820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 31821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 31822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 31823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 31824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 31825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 31826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 31827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 31828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 31829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 31830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 31831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 31832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 31833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 31834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 31835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 31836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 31837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 31838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 31839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 31840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 31841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 31842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 31843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 31844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 31845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 31846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 31847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 31848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 31849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 31850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 31851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 31852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 31853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 31854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 31855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 31856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 31857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 31858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 31859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 31860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 31861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 31862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 31863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 31864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 31865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 31866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 31867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 31868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 31869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 31870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 31871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 31872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 31873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 31874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 31875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 31876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 31877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 31878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 31879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 31880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 31881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 31882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 31883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 31884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 31885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 31886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 31887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 31888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 31889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 31890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 31891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 31892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 31893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 31894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 31895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 31896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 31897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 31898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 31899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 31900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 31901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 31902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 31903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 31904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 31905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 31906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 31907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 31908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 31909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 31910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 31911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 31912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 31913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 31914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 31915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 31916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 31917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 31918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 31919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 31920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 31921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 31922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 31923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 31924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 31925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 31926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 31927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 31928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 31929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 31930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 31931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 31932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 31933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 31934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 31935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 31936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 31937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 31938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 31939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 31940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 31941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 31942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 31943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 31944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 31945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 31946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 31947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 31948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 31949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 31950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 31951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 31952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 31953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 31954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 31955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 31956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 31957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 31958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 31959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 31960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 31961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 31962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 31963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 31964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 31965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 31966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 31967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 31968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 31969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 31970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 31971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 31972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 31973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 31974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 31975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 31976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 31977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 31978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 31979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 31980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 31981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 31982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 31983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 31984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 31985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 31986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 31987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 31988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 31989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 31990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 31991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 31992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 31993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 31994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 31995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 31996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 31997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 31998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 31999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 32000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 32001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 32002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 32003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 32004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 32005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 32006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 32007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 32008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 32009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 32010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 32011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 32012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 32013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 32014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 32015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 32016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 32017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 32018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 32019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 32020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 32021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 32022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 32023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 32024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 32025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 32026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 32027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 32028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 32029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 32030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 32031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 32032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 32033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 32034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 32035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 32036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 32037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 32038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 32039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 32040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 32041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 32042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 32043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 32044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 32045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 32046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 32047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 32048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 32049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 32050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 32051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 32052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 32053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 32054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 32055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 32056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 32057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 32058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 32059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 32060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 32061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 32062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 32063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 32064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 32065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 32066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 32067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 32068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 32069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 32070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 32071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 32072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 32073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 32074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 32075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 32076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 32077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 32078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 32079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 32080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 32081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 32082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 32083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 32084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 32085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 32086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 32087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 32088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 32089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 32090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 32091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 32092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 32093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 32094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 32095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 32096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 32097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 32098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 32099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 32100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 32101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 32102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 32103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 32104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 32105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 32106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 32107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 32108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 32109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 32110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 32111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 32112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 32113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 32114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 32115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 32116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 32117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 32118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 32119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 32120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 32121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 32122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 32123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 32124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 32125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 32126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 32127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 32128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 32129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 32130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 32131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 32132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 32133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 32134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 32135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 32136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 32137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 32138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 32139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 32140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 32141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 32142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 32143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 32144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 32145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 32146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 32147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 32148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 32149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 32150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 32151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 32152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 32153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 32154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 32155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 32156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 32157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 32158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 32159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 32160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 32161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 32162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 32163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 32164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 32165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 32166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 32167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 32168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 32169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 32170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 32171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 32172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 32173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 32174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 32175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 32176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 32177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 32178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 32179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 32180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 32181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 32182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 32183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 32184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 32185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 32186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 32187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 32188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 32189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 32190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 32191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 32192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 32193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 32194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 32195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 32196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 32197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 32198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 32199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 32200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 32201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 32202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 32203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 32204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 32205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 32206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 32207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 32208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 32209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 32210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 32211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 32212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 32213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 32214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 32215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 32216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 32217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 32218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 32219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 32220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 32221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 32222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 32223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 32224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 32225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 32226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 32227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 32228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 32229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 32230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 32231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 32232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 32233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 32234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 32235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 32236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 32237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 32238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 32239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 32240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 32241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 32242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 32243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 32244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 32245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 32246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 32247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 32248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 32249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 32250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 32251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 32252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 32253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 32254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 32255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 32256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 32257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 32258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 32259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 32260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 32261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 32262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 32263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 32264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 32265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 32266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 32267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 32268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 32269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 32270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 32271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 32272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 32273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 32274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 32275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 32276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 32277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 32278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 32279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 32280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 32281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 32282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 32283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 32284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 32285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 32286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 32287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 32288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 32289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 32290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 32291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 32292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 32293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 32294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 32295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 32296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 32297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 32298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 32299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 32300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 32301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 32302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 32303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 32304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 32305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 32306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 32307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 32308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 32309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 32310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 32311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 32312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 32313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 32314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 32315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 32316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 32317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 32318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 32319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 32320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 32321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 32322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 32323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 32324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 32325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 32326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 32327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 32328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 32329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 32330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 32331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 32332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 32333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 32334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 32335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 32336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 32337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 32338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 32339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 32340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 32341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 32342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 32343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 32344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 32345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 32346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 32347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 32348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 32349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 32350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 32351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 32352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 32353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 32354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 32355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 32356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 32357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 32358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 32359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 32360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 32361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 32362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 32363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 32364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 32365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 32366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 32367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 32368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 32369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 32370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 32371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 32372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 32373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 32374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 32375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 32376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 32377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 32378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 32379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 32380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 32381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 32382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 32383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 32384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 32385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 32386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 32387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 32388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 32389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 32390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 32391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 32392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 32393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 32394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 32395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 32396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 32397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 32398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 32399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 32400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 32401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 32402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 32403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 32404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 32405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 32406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 32407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 32408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 32409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 32410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 32411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 32412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 32413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 32414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 32415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 32416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 32417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 32418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 32419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 32420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 32421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 32422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 32423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 32424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 32425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 32426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 32427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 32428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 32429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 32430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 32431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 32432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 32433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 32434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 32435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 32436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 32437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 32438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 32439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 32440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 32441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 32442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 32443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 32444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 32445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 32446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 32447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 32448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 32449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 32450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 32451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 32452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 32453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 32454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 32455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 32456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 32457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 32458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 32459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 32460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 32461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 32462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 32463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 32464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 32465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 32466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 32467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 32468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 32469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 32470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 32471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 32472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 32473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 32474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 32475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 32476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 32477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 32478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 32479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 32480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 32481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 32482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 32483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 32484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 32485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 32486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 32487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 32488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 32489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 32490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 32491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 32492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 32493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 32494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 32495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 32496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 32497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 32498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 32499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 32500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 32501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 32502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 32503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 32504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 32505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 32506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 32507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 32508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 32509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 32510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 32511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 32512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 32513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 32514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 32515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 32516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 32517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 32518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 32519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 32520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 32521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 32522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 32523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 32524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 32525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 32526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 32527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 32528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 32529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 32530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 32531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 32532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 32533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 32534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 32535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 32536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 32537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 32538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 32539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 32540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 32541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 32542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 32543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 32544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 32545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 32546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 32547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 32548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 32549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 32550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 32551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 32552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 32553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 32554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 32555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 32556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 32557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 32558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 32559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 32560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 32561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 32562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 32563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 32564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 32565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 32566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 32567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 32568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 32569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 32570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 32571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 32572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 32573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 32574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 32575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 32576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 32577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 32578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 32579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 32580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 32581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 32582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 32583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 32584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 32585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 32586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 32587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 32588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 32589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 32590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 32591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 32592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 32593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 32594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 32595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 32596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 32597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 32598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 32599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 32600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 32601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 32602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 32603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 32604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 32605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 32606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 32607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 32608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 32609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 32610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 32611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 32612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 32613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 32614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 32615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 32616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 32617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 32618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 32619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 32620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 32621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 32622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 32623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 32624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 32625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 32626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 32627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 32628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 32629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 32630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 32631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 32632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 32633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 32634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 32635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 32636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 32637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 32638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 32639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 32640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 32641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 32642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 32643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 32644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 32645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 32646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 32647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 32648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 32649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 32650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 32651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 32652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 32653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 32654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 32655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 32656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 32657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 32658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 32659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 32660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 32661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 32662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 32663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 32664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 32665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 32666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 32667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 32668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 32669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 32670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 32671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 32672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 32673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 32674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 32675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 32676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 32677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 32678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 32679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 32680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 32681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 32682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 32683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 32684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 32685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 32686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 32687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 32688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 32689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 32690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 32691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 32692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 32693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 32694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 32695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 32696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 32697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 32698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 32699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 32700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 32701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 32702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 32703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 32704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 32705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 32706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 32707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 32708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 32709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 32710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 32711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 32712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 32713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 32714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 32715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 32716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 32717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 32718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 32719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 32720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 32721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 32722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 32723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 32724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 32725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 32726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 32727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 32728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 32729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 32730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 32731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 32732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 32733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 32734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 32735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 32736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 32737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 32738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 32739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 32740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 32741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 32742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 32743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 32744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 32745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 32746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 32747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 32748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 32749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 32750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 32751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 32752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 32753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 32754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 32755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 32756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 32757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 32758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 32759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 32760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 32761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 32762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 32763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 32764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 32765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 32766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 32767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 32768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 32769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 32770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 32771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 32772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 32773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 32774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 32775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 32776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 32777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 32778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 32779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 32780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 32781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 32782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 32783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 32784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 32785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 32786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 32787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 32788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 32789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 32790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 32791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 32792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 32793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 32794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 32795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 32796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 32797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 32798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 32799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 32800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 32801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 32802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 32803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 32804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 32805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 32806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 32807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 32808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 32809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 32810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 32811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 32812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 32813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 32814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 32815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 32816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 32817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 32818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 32819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 32820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 32821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 32822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 32823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 32824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 32825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 32826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 32827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 32828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 32829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 32830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 32831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 32832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 32833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 32834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 32835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 32836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 32837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 32838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 32839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 32840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 32841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 32842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 32843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 32844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 32845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 32846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 32847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 32848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 32849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 32850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 32851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 32852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 32853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 32854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 32855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 32856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 32857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 32858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 32859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 32860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 32861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 32862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 32863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 32864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 32865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 32866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 32867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 32868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 32869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 32870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 32871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 32872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 32873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 32874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 32875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 32876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 32877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 32878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 32879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 32880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 32881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 32882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 32883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 32884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 32885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 32886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 32887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 32888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 32889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 32890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 32891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 32892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 32893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 32894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 32895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 32896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 32897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 32898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 32899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 32900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 32901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 32902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 32903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 32904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 32905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 32906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 32907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 32908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 32909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 32910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 32911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 32912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 32913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 32914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 32915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 32916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 32917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 32918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 32919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 32920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 32921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 32922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 32923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 32924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 32925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 32926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 32927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 32928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 32929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 32930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 32931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 32932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 32933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 32934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 32935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 32936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 32937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 32938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 32939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 32940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 32941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 32942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 32943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 32944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 32945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 32946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 32947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 32948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 32949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 32950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 32951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 32952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 32953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 32954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 32955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 32956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 32957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 32958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 32959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 32960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 32961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 32962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 32963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 32964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 32965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 32966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 32967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 32968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 32969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 32970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 32971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 32972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 32973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 32974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 32975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 32976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 32977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 32978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 32979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 32980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 32981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 32982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 32983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 32984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 32985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 32986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 32987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 32988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 32989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 32990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 32991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 32992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 32993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 32994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 32995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 32996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 32997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 32998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 32999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 33000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 33001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 33002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 33003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 33004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 33005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 33006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 33007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 33008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 33009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 33010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 33011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 33012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 33013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 33014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 33015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 33016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 33017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 33018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 33019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 33020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 33021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 33022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 33023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 33024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 33025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 33026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 33027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 33028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 33029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 33030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 33031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 33032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 33033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 33034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 33035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 33036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 33037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 33038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 33039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 33040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 33041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 33042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 33043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 33044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 33045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 33046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 33047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 33048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 33049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 33050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 33051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 33052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 33053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 33054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 33055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 33056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 33057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 33058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 33059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 33060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 33061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 33062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 33063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 33064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 33065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 33066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 33067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 33068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 33069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 33070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 33071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 33072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 33073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 33074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 33075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 33076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 33077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 33078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 33079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 33080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 33081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 33082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 33083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 33084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 33085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 33086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 33087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 33088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 33089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 33090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 33091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 33092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 33093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 33094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 33095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 33096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 33097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 33098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 33099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 33100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 33101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 33102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 33103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 33104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 33105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 33106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 33107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 33108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 33109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 33110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 33111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 33112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 33113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 33114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 33115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 33116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 33117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 33118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 33119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 33120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 33121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 33122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 33123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 33124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 33125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 33126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 33127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 33128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 33129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 33130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 33131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 33132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 33133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 33134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 33135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 33136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 33137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 33138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 33139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 33140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 33141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 33142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 33143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 33144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 33145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 33146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 33147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 33148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 33149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 33150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 33151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 33152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 33153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 33154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 33155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 33156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 33157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 33158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 33159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 33160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 33161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 33162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 33163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 33164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 33165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 33166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 33167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 33168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 33169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 33170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 33171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 33172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 33173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 33174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 33175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 33176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 33177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 33178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 33179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 33180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 33181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 33182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 33183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 33184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 33185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 33186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 33187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 33188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 33189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 33190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 33191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 33192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 33193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 33194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 33195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 33196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 33197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 33198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 33199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 33200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 33201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 33202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 33203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 33204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 33205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 33206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 33207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 33208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 33209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 33210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 33211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 33212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 33213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 33214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 33215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 33216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 33217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 33218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 33219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 33220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 33221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 33222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 33223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 33224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 33225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 33226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 33227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 33228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 33229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 33230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 33231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 33232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 33233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 33234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 33235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 33236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 33237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 33238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 33239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 33240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 33241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 33242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 33243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 33244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 33245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 33246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 33247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 33248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 33249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 33250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 33251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 33252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 33253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 33254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 33255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 33256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 33257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 33258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 33259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 33260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 33261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 33262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 33263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 33264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 33265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 33266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 33267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 33268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 33269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 33270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 33271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 33272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 33273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 33274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 33275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 33276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 33277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 33278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 33279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 33280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 33281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 33282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 33283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 33284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 33285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 33286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 33287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 33288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 33289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 33290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 33291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 33292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 33293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 33294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 33295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 33296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 33297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 33298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 33299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 33300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 33301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 33302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 33303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 33304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 33305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 33306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 33307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 33308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 33309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 33310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 33311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 33312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 33313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 33314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 33315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 33316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 33317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 33318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 33319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 33320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 33321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 33322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 33323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 33324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 33325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 33326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 33327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 33328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 33329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 33330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 33331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 33332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 33333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 33334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 33335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 33336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 33337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 33338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 33339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 33340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 33341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 33342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 33343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 33344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 33345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 33346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 33347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 33348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 33349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 33350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 33351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 33352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 33353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 33354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 33355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 33356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 33357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 33358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 33359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 33360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 33361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 33362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 33363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 33364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 33365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 33366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 33367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 33368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 33369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 33370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 33371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 33372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 33373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 33374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 33375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 33376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 33377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 33378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 33379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 33380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 33381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 33382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 33383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 33384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 33385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 33386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 33387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 33388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 33389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 33390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 33391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 33392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 33393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 33394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 33395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 33396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 33397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 33398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 33399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 33400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 33401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 33402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 33403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 33404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 33405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 33406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 33407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 33408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 33409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 33410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 33411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 33412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 33413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 33414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 33415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 33416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 33417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 33418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 33419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 33420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 33421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 33422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 33423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 33424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 33425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 33426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 33427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 33428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 33429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 33430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 33431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 33432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 33433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 33434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 33435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 33436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 33437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 33438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 33439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 33440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 33441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 33442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 33443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 33444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 33445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 33446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 33447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 33448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 33449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 33450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 33451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 33452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 33453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 33454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 33455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 33456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 33457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 33458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 33459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 33460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 33461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 33462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 33463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 33464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 33465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 33466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 33467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 33468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 33469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 33470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 33471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 33472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 33473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 33474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 33475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 33476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 33477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 33478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 33479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 33480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 33481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 33482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 33483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 33484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 33485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 33486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 33487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 33488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 33489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 33490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 33491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 33492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 33493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 33494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 33495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 33496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 33497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 33498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 33499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 33500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 33501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 33502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 33503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 33504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 33505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 33506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 33507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 33508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 33509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 33510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 33511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 33512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 33513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 33514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 33515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 33516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 33517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 33518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 33519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 33520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 33521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 33522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 33523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 33524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 33525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 33526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 33527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 33528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 33529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 33530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 33531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 33532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 33533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 33534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 33535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 33536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 33537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 33538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 33539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 33540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 33541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 33542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 33543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 33544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 33545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 33546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 33547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 33548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 33549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 33550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 33551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 33552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 33553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 33554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 33555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 33556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 33557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 33558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 33559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 33560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 33561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 33562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 33563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 33564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 33565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 33566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 33567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 33568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 33569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 33570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 33571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 33572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 33573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 33574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 33575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 33576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 33577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 33578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 33579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 33580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 33581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 33582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 33583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 33584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 33585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 33586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 33587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 33588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 33589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 33590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 33591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 33592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 33593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 33594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 33595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 33596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 33597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 33598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 33599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 33600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 33601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 33602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 33603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 33604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 33605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 33606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 33607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 33608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 33609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 33610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 33611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 33612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 33613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 33614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 33615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 33616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 33617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 33618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 33619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 33620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 33621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 33622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 33623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 33624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 33625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 33626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 33627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 33628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 33629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 33630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 33631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 33632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 33633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 33634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 33635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 33636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 33637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 33638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 33639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 33640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 33641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 33642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 33643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 33644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 33645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 33646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 33647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 33648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 33649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 33650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 33651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 33652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 33653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 33654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 33655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 33656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 33657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 33658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 33659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 33660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 33661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 33662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 33663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 33664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 33665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 33666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 33667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 33668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 33669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 33670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 33671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 33672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 33673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 33674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 33675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 33676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 33677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 33678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 33679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 33680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 33681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 33682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 33683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 33684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 33685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 33686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 33687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 33688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 33689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 33690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 33691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 33692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 33693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 33694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 33695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 33696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 33697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 33698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 33699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 33700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 33701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 33702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 33703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 33704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 33705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 33706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 33707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 33708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 33709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 33710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 33711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 33712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 33713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 33714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 33715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 33716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 33717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 33718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 33719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 33720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 33721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 33722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 33723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 33724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 33725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 33726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 33727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 33728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 33729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 33730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 33731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 33732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 33733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 33734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 33735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 33736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 33737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 33738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 33739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 33740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 33741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 33742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 33743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 33744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 33745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 33746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 33747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 33748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 33749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 33750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 33751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 33752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 33753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 33754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 33755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 33756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 33757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 33758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 33759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 33760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 33761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 33762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 33763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 33764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 33765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 33766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 33767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 33768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 33769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 33770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 33771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 33772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 33773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 33774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 33775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 33776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 33777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 33778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 33779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 33780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 33781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 33782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 33783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 33784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 33785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 33786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 33787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 33788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 33789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 33790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 33791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 33792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 33793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 33794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 33795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 33796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 33797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 33798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 33799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 33800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 33801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 33802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 33803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 33804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 33805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 33806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 33807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 33808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 33809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 33810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 33811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 33812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 33813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 33814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 33815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 33816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 33817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 33818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 33819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 33820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 33821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 33822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 33823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 33824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 33825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 33826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 33827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 33828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 33829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 33830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 33831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 33832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 33833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 33834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 33835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 33836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 33837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 33838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 33839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 33840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 33841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 33842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 33843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 33844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 33845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 33846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 33847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 33848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 33849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 33850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 33851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 33852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 33853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 33854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 33855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 33856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 33857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 33858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 33859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 33860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 33861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 33862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 33863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 33864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 33865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 33866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 33867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 33868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 33869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 33870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 33871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 33872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 33873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 33874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 33875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 33876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 33877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 33878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 33879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 33880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 33881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 33882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 33883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 33884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 33885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 33886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 33887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 33888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 33889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 33890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 33891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 33892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 33893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 33894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 33895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 33896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 33897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 33898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 33899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 33900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 33901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 33902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 33903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 33904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 33905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 33906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 33907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 33908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 33909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 33910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 33911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 33912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 33913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 33914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 33915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 33916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 33917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 33918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 33919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 33920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 33921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 33922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 33923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 33924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 33925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 33926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 33927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 33928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 33929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 33930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 33931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 33932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 33933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 33934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 33935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 33936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 33937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 33938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 33939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 33940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 33941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 33942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 33943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 33944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 33945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 33946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 33947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 33948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 33949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 33950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 33951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 33952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 33953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 33954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 33955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 33956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 33957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 33958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 33959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 33960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 33961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 33962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 33963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 33964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 33965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 33966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 33967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 33968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 33969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 33970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 33971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 33972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 33973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 33974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 33975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 33976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 33977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 33978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 33979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 33980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 33981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 33982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 33983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 33984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 33985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 33986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 33987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 33988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 33989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 33990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 33991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 33992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 33993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 33994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 33995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 33996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 33997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 33998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 33999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 34000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 34001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 34002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 34003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 34004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 34005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 34006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 34007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 34008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 34009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 34010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 34011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 34012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 34013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 34014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 34015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 34016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 34017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 34018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 34019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 34020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 34021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 34022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 34023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 34024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 34025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 34026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 34027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 34028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 34029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 34030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 34031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 34032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 34033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 34034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 34035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 34036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 34037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 34038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 34039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 34040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 34041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 34042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 34043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 34044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 34045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 34046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 34047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 34048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 34049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 34050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 34051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 34052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 34053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 34054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 34055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 34056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 34057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 34058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 34059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 34060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 34061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 34062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 34063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 34064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 34065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 34066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 34067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 34068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 34069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 34070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 34071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 34072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 34073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 34074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 34075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 34076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 34077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 34078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 34079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 34080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 34081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 34082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 34083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 34084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 34085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 34086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 34087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 34088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 34089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 34090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 34091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 34092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 34093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 34094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 34095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 34096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 34097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 34098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 34099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 34100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 34101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 34102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 34103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 34104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 34105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 34106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 34107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 34108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 34109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 34110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 34111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 34112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 34113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 34114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 34115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 34116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 34117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 34118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 34119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 34120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 34121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 34122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 34123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 34124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 34125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 34126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 34127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 34128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 34129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 34130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 34131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 34132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 34133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 34134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 34135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 34136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 34137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 34138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 34139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 34140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 34141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 34142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 34143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 34144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 34145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 34146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 34147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 34148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 34149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 34150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 34151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 34152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 34153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 34154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 34155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 34156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 34157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 34158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 34159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 34160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 34161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 34162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 34163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 34164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 34165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 34166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 34167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 34168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 34169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 34170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 34171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 34172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 34173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 34174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 34175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 34176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 34177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 34178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 34179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 34180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 34181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 34182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 34183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 34184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 34185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 34186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 34187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 34188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 34189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 34190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 34191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 34192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 34193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 34194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 34195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 34196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 34197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 34198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 34199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 34200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 34201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 34202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 34203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 34204 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 34205 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 34206 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 34207 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 34208 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 34209 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 34210 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 34211 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 34212 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 34213 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 34214 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 34215 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 34216 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 34217 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 34218 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 34219 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 34220 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 34221 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 34222 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 34223 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 34224 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 34225 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 34226 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 34227 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 34228 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 34229 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 34230 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 34231 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 34232 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 34233 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 34234 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 34235 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 34236 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 34237 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 34238 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 34239 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 34240 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 34241 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 34242 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 34243 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 34244 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 34245 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 34246 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 34247 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 34248 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 34249 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 34250 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 34251 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 34252 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 34253 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 34254 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 34255 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 34256 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 34257 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 34258 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 34259 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 34260 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 34261 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 34262 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 34263 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 34264 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 34265 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 34266 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 34267 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 34268 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 34269 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 34270 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 34271 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 34272 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 34273 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 34274 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 34275 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 34276 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 34277 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 34278 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 34279 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 34280 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 34281 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 34282 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 34283 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 34284 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 34285 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 34286 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 34287 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 34288 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 34289 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 34290 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 34291 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 34292 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 34293 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 34294 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 34295 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 34296 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 34297 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 34298 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 34299 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 34300 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 34301 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 34302 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 34303 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 34304 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 34305 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 34306 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 34307 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 34308 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 34309 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 34310 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 34311 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 34312 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 34313 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 34314 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 34315 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 34316 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 34317 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 34318 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 34319 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 34320 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 34321 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 34322 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 34323 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 34324 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 34325 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 34326 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 34327 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 34328 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 34329 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 34330 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 34331 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 34332 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 34333 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 34334 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 34335 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 34336 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 34337 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 34338 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 34339 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 34340 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 34341 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 34342 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 34343 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 34344 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 34345 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 34346 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 34347 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 34348 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 34349 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 34350 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 34351 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 34352 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 34353 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 34354 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 34355 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 34356 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 34357 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 34358 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 34359 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 34360 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 34361 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 34362 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 34363 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 34364 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 34365 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 34366 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 34367 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 34368 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 34369 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 34370 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 34371 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 34372 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 34373 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 34374 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 34375 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 34376 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 34377 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 34378 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 34379 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 34380 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 34381 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 34382 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 34383 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 34384 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 34385 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 34386 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 34387 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 34388 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 34389 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 34390 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 34391 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 34392 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 34393 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 34394 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 34395 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 34396 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 34397 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 34398 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 34399 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 34400 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 34401 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 34402 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 34403 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 34404 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 34405 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 34406 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 34407 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 34408 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 34409 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 34410 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 34411 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 34412 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 34413 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 34414 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 34415 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 34416 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 34417 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 34418 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 34419 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 34420 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 34421 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 34422 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 34423 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 34424 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 34425 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 34426 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 34427 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 34428 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 34429 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 34430 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 34431 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 34432 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 34433 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 34434 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 34435 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 34436 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 34437 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 34438 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 34439 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 34440 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 34441 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 34442 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 34443 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 34444 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 34445 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 34446 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 34447 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 34448 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 34449 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 34450 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 34451 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 34452 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 34453 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 34454 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 34455 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 34456 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 34457 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 34458 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 34459 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 34460 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 34461 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 34462 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 34463 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 34464 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 34465 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 34466 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 34467 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 34468 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 34469 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 34470 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 34471 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 34472 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 34473 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 34474 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 34475 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 34476 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 34477 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 34478 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 34479 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 34480 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 34481 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 34482 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 34483 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 34484 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 34485 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 34486 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 34487 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 34488 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 34489 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 34490 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 34491 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 34492 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 34493 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 34494 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 34495 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 34496 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 34497 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 34498 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 34499 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 34500 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 34501 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 34502 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 34503 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 34504 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 34505 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 34506 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 34507 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 34508 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 34509 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 34510 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 34511 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 34512 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 34513 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 34514 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 34515 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 34516 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 34517 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 34518 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 34519 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 34520 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 34521 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 34522 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 34523 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 34524 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 34525 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 34526 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 34527 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 34528 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 34529 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 34530 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 34531 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 34532 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 34533 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 34534 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 34535 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 34536 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 34537 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 34538 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 34539 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 34540 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 34541 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 34542 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 34543 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 34544 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 34545 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 34546 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 34547 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 34548 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 34549 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 34550 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 34551 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 34552 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 34553 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 34554 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 34555 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 34556 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 34557 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 34558 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 34559 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 34560 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 34561 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 34562 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 34563 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 34564 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 34565 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 34566 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 34567 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 34568 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 34569 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 34570 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 34571 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 34572 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 34573 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 34574 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 34575 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 34576 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 34577 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 34578 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 34579 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 34580 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 34581 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 34582 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 34583 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 34584 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 34585 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 34586 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 34587 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 34588 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 34589 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 34590 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 34591 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 34592 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 34593 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 34594 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 34595 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 34596 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 34597 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 34598 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 34599 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 34600 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 34601 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 34602 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 34603 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 34604 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 34605 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 34606 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 34607 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 34608 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 34609 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 34610 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 34611 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 34612 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 34613 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 34614 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 34615 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 34616 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 34617 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 34618 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 34619 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 34620 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 34621 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 34622 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 34623 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 34624 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 34625 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 34626 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 34627 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 34628 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 34629 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 34630 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 34631 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 34632 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 34633 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 34634 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 34635 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 34636 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 34637 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 34638 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 34639 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 34640 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 34641 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 34642 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 34643 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 34644 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 34645 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 34646 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 34647 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 34648 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 34649 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 34650 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 34651 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 34652 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 34653 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 34654 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 34655 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 34656 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 34657 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 34658 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 34659 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 34660 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 34661 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 34662 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 34663 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 34664 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 34665 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 34666 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 34667 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 34668 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 34669 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 34670 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 34671 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 34672 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 34673 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 34674 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 34675 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 34676 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 34677 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 34678 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 34679 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 34680 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 34681 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 34682 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 34683 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 34684 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 34685 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 34686 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 34687 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 34688 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 34689 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 34690 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 34691 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 34692 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 34693 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 34694 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 34695 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 34696 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 34697 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 34698 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 34699 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 34700 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 34701 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 34702 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 34703 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 34704 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 34705 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 34706 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 34707 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 34708 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 34709 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 34710 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 34711 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 34712 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 34713 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 34714 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 34715 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 34716 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 34717 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 34718 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 34719 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 34720 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 34721 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 34722 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 34723 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 34724 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 34725 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 34726 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 34727 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 34728 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 34729 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 34730 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 34731 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 34732 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 34733 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 34734 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 34735 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 34736 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 34737 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 34738 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 34739 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 34740 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 34741 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 34742 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 34743 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 34744 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 34745 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 34746 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 34747 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 34748 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 34749 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 34750 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 34751 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 34752 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 34753 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 34754 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 34755 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 34756 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 34757 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 34758 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 34759 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 34760 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 34761 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 34762 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 34763 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 34764 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 34765 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 34766 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 34767 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 34768 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 34769 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 34770 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 34771 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 34772 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 34773 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 34774 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 34775 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 34776 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 34777 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 34778 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 34779 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 34780 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 34781 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 34782 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 34783 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 34784 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 34785 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 34786 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 34787 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 34788 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 34789 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 34790 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 34791 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 34792 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 34793 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 34794 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 34795 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 34796 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 34797 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 34798 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 34799 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 34800 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 34801 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 34802 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 34803 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 34804 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 34805 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 34806 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 34807 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 34808 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 34809 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 34810 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 34811 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 34812 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 34813 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 34814 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 34815 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 34816 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 34817 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 34818 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 34819 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 34820 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 34821 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 34822 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 34823 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 34824 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 34825 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 34826 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 34827 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 34828 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 34829 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 34830 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 34831 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 34832 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 34833 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 34834 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 34835 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 34836 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 34837 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 34838 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 34839 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 34840 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 34841 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 34842 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 34843 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 34844 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 34845 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 34846 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 34847 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 34848 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 34849 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 34850 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 34851 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 34852 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 34853 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 34854 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 34855 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 34856 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 34857 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 34858 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 34859 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 34860 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 34861 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 34862 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 34863 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 34864 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 34865 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 34866 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 34867 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 34868 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 34869 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 34870 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 34871 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 34872 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 34873 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 34874 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 34875 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 34876 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 34877 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 34878 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 34879 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 34880 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 34881 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 34882 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 34883 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 34884 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 34885 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 34886 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 34887 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 34888 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 34889 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 34890 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 34891 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 34892 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 34893 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 34894 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 34895 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 34896 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 34897 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 34898 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 34899 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 34900 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 34901 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 34902 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 34903 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 34904 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 34905 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 34906 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 34907 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 34908 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 34909 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 34910 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 34911 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 34912 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 34913 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 34914 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 34915 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 34916 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 34917 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 34918 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 34919 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 34920 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 34921 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 34922 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 34923 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 34924 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 34925 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 34926 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 34927 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 34928 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 34929 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 34930 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 34931 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 34932 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 34933 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 34934 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 34935 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 34936 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 34937 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 34938 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 34939 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 34940 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 34941 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 34942 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 34943 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 34944 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 34945 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 34946 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 34947 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 34948 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 34949 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 34950 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 34951 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 34952 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 34953 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 34954 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 34955 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 34956 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 34957 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 34958 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 34959 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 34960 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 34961 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 34962 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 34963 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 34964 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 34965 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 34966 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 34967 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 34968 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 34969 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 34970 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 34971 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 34972 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 34973 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 34974 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 34975 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 34976 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 34977 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 34978 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 34979 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 34980 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 34981 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 34982 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 34983 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 34984 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 34985 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 34986 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 34987 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 34988 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 34989 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 34990 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 34991 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 34992 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 34993 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 34994 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 34995 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 34996 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 34997 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 34998 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 34999 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 35000 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 35001 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 35002 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 35003 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 35004 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 35005 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 35006 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 35007 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 35008 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 35009 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 35010 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 35011 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 35012 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 35013 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 35014 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 35015 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 35016 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 35017 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 35018 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 35019 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 35020 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 35021 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 35022 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 35023 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 35024 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 35025 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 35026 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 35027 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 35028 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 35029 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 35030 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 35031 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 35032 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 35033 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 35034 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 35035 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 35036 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 35037 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 35038 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 35039 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 35040 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 35041 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 35042 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 35043 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 35044 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 35045 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 35046 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 35047 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 35048 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 35049 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 35050 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 35051 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 35052 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 35053 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 35054 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 35055 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 35056 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 35057 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 35058 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 35059 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 35060 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 35061 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 35062 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 35063 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 35064 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 35065 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 35066 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 35067 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 35068 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 35069 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 35070 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 35071 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 35072 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 35073 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 35074 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 35075 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 35076 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 35077 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 35078 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 35079 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 35080 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 35081 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 35082 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 35083 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 35084 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 35085 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 35086 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 35087 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 35088 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 35089 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 35090 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 35091 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 35092 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 35093 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 35094 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 35095 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 35096 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 35097 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 35098 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 35099 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 35100 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 35101 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 35102 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 35103 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 35104 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 35105 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 35106 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 35107 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 35108 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 35109 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 35110 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 35111 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 35112 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 35113 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 35114 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 35115 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 35116 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 35117 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 35118 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 35119 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 35120 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 35121 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 35122 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 35123 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 35124 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 35125 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 35126 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 35127 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 35128 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 35129 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 35130 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 35131 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 35132 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 35133 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 35134 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 35135 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 35136 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 35137 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 35138 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 35139 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 35140 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 35141 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 35142 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 35143 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 35144 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 35145 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 35146 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 35147 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 35148 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 35149 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 35150 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 35151 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 35152 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 35153 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 35154 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 35155 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 35156 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 35157 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 35158 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 35159 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 35160 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 35161 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 35162 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 35163 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 35164 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 35165 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 35166 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 35167 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 35168 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 35169 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 35170 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 35171 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 35172 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 35173 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 35174 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 35175 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 35176 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 35177 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 35178 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 35179 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 35180 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 35181 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 35182 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 35183 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 35184 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 35185 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 35186 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 35187 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 35188 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 35189 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 35190 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 35191 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 35192 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 35193 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 35194 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 35195 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 35196 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 35197 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 35198 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 35199 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 35200 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 35201 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 35202 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 35203 - protein, 174 aa, Artificial Sequence
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDASGEPPSMTQLLRR
